United States Patent 10,233,495 (METHODS AND COMPOSITIONS FOR SCREENING AND TREATING DEVELOPMENTAL DISORDERS) - sequence listing, part 19

SEQ ID NO: 86 - DNA, 173764 bp, Homo sapiens
ttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 87 - DNA, 167695 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgtttt

SEQ ID NO: 88 - DNA, 29890 bp, Homo sapiens
cttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttgg

SEQ ID NO: 89 - DNA, 33174 bp, Homo sapiens
cttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttggtttcccctgtctttgtccacagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggtgaccgacccagccacctgcatccaggcagggccctcccaatccagggacactcatagatagaaggttctgggtggtgcctgtggtttcctgcagtgtttgtcacttgtgcttcctgcagctgctgctgcttggccctggagttggggggagactttggcttcagtgactctccatggccaggtggggttgagtctgcccaatggcaaagtgcttcctgaggaccctcccaggatcccctcacagacacagctctcaccaggaatgattcggaactgtgggatttgaggactcagggcctacctgactcacaaggccaggatgtccctgtgccctctcttgggcttcatcctgcggagagacagactggggcaggagaggctgatcaggggttttgtcctgcccagggtggagcccacagcaaggccagaacaggtcccatgtcaggatgcaaagatggccagcagttggggaagaactgggccaggaaaggctgagggggccaggctaggctggccaggagccctgagcccaagggactttcttccctggcccctacccagcacagcctctgtctggagaggccaagttctgcttggctctgttgctggaaactgggggcttctctgggctctatgagctcaatgtgggcctcgctggatccacacacactgcttggaacatcctttcaagggtgccagtctccatcaccgcctaagcagtgggactcccccaggaatgacccacagccccttctcagcacaaaccatgtcatccacttcaccctgcatcccctctgatggaatccctccctgtctttgtccccatcacaatcacagtccttgctgccctgctgtccccaacttgaccgattcctagtcttagtggaaaatccttttctctgaagtttggagtaaataccatatttctataagtcaaaataatgacaattataccatgtcacagggaccttcccacattggagtgagtcctgctggtcttctcttccccactacttttggtggaattcattttggcctaagtctatatcacatttgggctcagcacaggttgtggcacagaatagaagtttctagaattatgggccacagatgggatgggagtaggggagttgatgagtagagcaggtcaatctccccttgaaggaagcacactcactcaggggcatcaggccaatgaccttggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatattggagctggggcaaaataaaacctcattgctcctgatctgtttgtatttaaatgggcaacattttgcttatcttgggatttttgcataacatctgatatttttaatattgcatagaaaatcatgcatcctaataaccggggttttggcgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatatgggcccggggagggtggctggaagtggaagcagaacttggggatttccgaaagaaagagaactgggctggcccagattccaatgggaaggaagtacctgatgaaggagctaagtccctaggggagggagagggaaaggagggactgaaaccaggatgtgggaagtctgtcctgagagtcatgggcccttggtgctgccccctccccacaacaggagcgtgacttatctcccctgtcccttttcagagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaatt

SEQ ID NO: 90 - DNA, 573622 bp, Homo sapiens
  misc_feature (205792)..(305791): n is a, c, g, or t
agatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttg

SEQ ID NO: 91 - DNA, 776648 bp, Homo sapiens
  misc_feature (374233)..(474232): n is a, c, g, or t
aggaaaagttgttgaggttataaaggatgaactctaggtatgttgaacattggtctgaagctattgtgtagtgattaagagagtaagctttgcagtcataatgacgtgggtacaaattccagctctgtctctcaatagcatgagaccttagagaaattaacttctaatctttagtatcttaataaatgggaatttagaaataatttccaaaggattgctataatgtttcaaatgatttttttaaaggcagttaagtgatcaataagctggagctattgttatttttattgtttctgtagttcaggaaagatggattgttctaacaattattgttggtgaacttaaccagaaaatgtagtattgagtgactcagatttttggcctagctatgggtggaaataactttctgggtaaagatgctgaactaaaaacttgcagccaaaaatcctcttcagacctcagggatcatcacaatataattgtaaaaatataacaatgaacatggaagtacagatatctcttttgagagcctgatttcaattgttttggatatatacacagaaatagaattgctggatcatatggtagttctatatttgaggaacttccatactcttttttttttttatatagtcgctgcaccgttttacattcctgctatggtgtataagtattccaatttctccgtatccttgccaaaacctggtatcttttgaaacaacttatacgtctgttgaaagatgaatgggttaaaaaacatatggtttatacattcaattgaatactattcagtcttaaaaaagaagaaaatcggccagtcacagtggcttatgcctgtaatctcggcactttgggaggccaaggcaagccgatcactagacgccaggagttggagatcagcttggcatacatggcgaaaccccatcactactaaaaatacaaaagttagcctggcatggtagctcgcacctgtaatcccagctactcaggaggctgacaggacaatcggttgagcctgggaggcagaggttgtagtgacccgagatcgcaccactgcactccagcctaggccgcagaggagagactgtgtctcaaataaaaataaaaataaaaataaaaaaaggaaatcttgctgtatgtaacaacatgaatgaccctggaggatgttctgctaagtgaaataaatcagtcggagaaggacaaatactgtactgcatgattccacttctatgaagtatctaaaatattcacattcacggaaacagtaagatggttgttgccagggactagggggaaagggaaatggggagttgctgttcaacaggtataaagttttatttctgcaagacaaataagttatagagagctgctgtacaatgttgtgcctgctgttaatgatactgtattctgcacttaacattttgttgagggtagatttcatgttcaaggttcttactgcaataaaattttttttaaaaaacctcaataattaccaaaaaattatttcaatatgtagtaaaaagaaatataatgcttctgaaggcagttccttttgtactgatgataacgaattgtgaattgagatgagtggaatttagcaataaaaagtgtcaagagcattgggcaatattgatgtcaattctacctaatttcatctatagatttggaacaatcccaatcaaaacctcagtgctttttaacagaaattcacaatattgagtttcttgttaattgaaatttacaaggaaaggtaatggatataggatatcgaaaacaattttggaaaacaacaacaattttggaggactagcattacctgatttcagggcttactacaaacttatggtatcaagatagtgtggtatttatgtaaagtaagacaaatacatcaatagatcagaacacagtgtccaaaagtagagtcacagatattatggtcaattgaatttgacaaaggtaccaacataattgaaatgtgtagaaggatagccttttcgacaaatagtgttgaggcaattagatatacatatggaaataaatgaccgtgacccctaccttacataatacacaaaaattaattcaaaatggatgataggtctaaatataaaagttgttttaaaacttctagaagaaaacatgggagaaaatttttaccaccttggagtaggaaaagatttctcatataaaataatcacaagtcctaacatttttaaaaattaatacaattgcagctcaaaaaattaaaatgttatggtctttaaaagatgctaaatgaataagtaagtgaataaggcacattacagactaggagaaaatagttacaaaacatttgtccaacaaaagactcgtaggatatatacagagagaggacttgctactcagtaaaaagacaaatatcccaatttgaaaaaatagacaaaagacttcatcatagaagatgtgttgaacaggcaattatcacatcattgtcatcatgaaatatcacttcaatcccactggaatggctaaaattaataagattggaaatagcaagtgtcgcacaggcatggtggctcacacctgtaatcctagcactttgggaggctgaggcgggaagattgtttgggcttggagtttgagaccagcctgggcaacatagtgagacatctctacaaaaaattttaaaaattagcagggcatggtagcacatgcctgtagtcccagctatttgggaggctgaagtgggaagaactcttgagcctggggaggagagggctgcagtgagccctgattacaccactgcactccatcctgggtgacagagtaagaccctgtgtcaataaataaataaatacataataaaaaatgaaaatagcaaatgttggcaaggatctgaagcaattagagcatttatactttgctagtaggaatataaaatagtacaaccactttggaaaacagtagtaattatttattatgaatctaaacaagtacttatcataggacccaatatttcccctcctaacaaaaacaaattgtgtcatatttatcagtcaaaatactgctcagcaataaaacaaaaactacacatgacaacatggatgaatctcacatatatgctgagtgaaagatgctggacacaatatggttgagatgacactagtcattaagaaataaatcacatttgtggttcccaggtgcaagaatgttggggaagtttaatggcaaaggagcatgagaaaccttctagggagatggaaatgctctatatcttgattgttgtggtggttacgtggatgaatacaaagactctctccttgaccaaacttagtcaggctcctctgataccttttgtcaactagaccttgaccttaggcttccatgtctttatttgttcagttttagctagactcctgctaagtcactttagtaagagtcccttgcttttggtatctggtcaccttcaaaatctgatcaaattcattattctctaccttcccccagatgatatctgatcaccctaacctgcctttagaaagaatactatcaaatcagtttagcaagaatctcctcttaccccttgctatgatttggatgtttgtcccctccaaaatcatgttgaaatttaattgccattgtaacagtattaagaagtgagacccttaagaggtgattaggcaataaaggctccaccctcataagtgggactgatattataaaaaggagacttcaaccctctgttggcctttttgccttccaccatggaatgatgctgcaagaaggctcttaccagatgtcagcaccttgacattgaacttctcagctttctgaactatgaaccaataaatttctgttcattataaatgacccagtctcttgggccaggcatggtggctcacgcctgtaatcccagcactttgggaggccaaggtgggtggatcacttgagatcaggagttcaagaccagccttatcaacatggagaaaccccgtctctactaaaaatacaaaattagccaagcgtggtggttcatgcctgtaatcccagctactcaggaggctgagacaggagaatcgcttgaacccgggaagcggagatttcagtgagccgagattgcgccattgcactccagcctgggcatacagagcaagactccgtctcaaaaaaaaataaataaataaataaataaataaataaattacccagtctcaggtattctgttacagcagcacaaaatggacaaagacacccctaatgtttcctcttagtaattttcaatccactgacccccaaccctgttcatttgctataaatctccccttgttcatgctgtattcagaattgagcccaattccatactgaggtttattttcctacattgcaatatttactaaataaaatttgttttttctgctctagctactattcaactgtgattttctttaacagtgtaatgcagcagagtcatttgtgttgtgccaagttcctgcctgtgaaatttagcatatgttgtagttttaaaataactaacattttaccaatacatttacttataacttctttttgacatatattatcttatttaacattctgaaacagcttgtgatttaattacaataacaccaattatatttttaattgaaaaataaataaaaggaatatttaaatatcactgggtattcttaaatttggaaatgtattaatcttcagatttaagaccaggtacctaagccttttcttccacagtaggatgtcaatgttaaattttcatttagcttttacatgtaccacagaatgcagccttgaatcctttaatagcaattatattggtttattgagtttcataacaggaaatagactatcaaaatataagtacttccaaaaaaagataacattttacaaggcccttttttggaaaacatggttaattattcctgagatatttatagaattctggaattctgaagttgttctgcttacttttgagtaatatcggtagctgacattttctgagtactgactgtgcccaatctgctctgtgtgctgcctatattttacctcacttaattcttatcacagtcttataagggattttttttttttttttgagacagagtatgccctatgtggcccaggctggagtgcagtggtgcgatcttggctcactgcaacctctgtttcctgggttcaagcgattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataaccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttactcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacggaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctgccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtggggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcacgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgttttttggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacatggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcaactgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaaccttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctgtgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggtctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccacatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaagtgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagcctggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagagaattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgaacaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggacgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctgaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagatgaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacgtgatatttaaaatatataacaattagtacaacatagggcactgaccaatcagaacagacaccagccaaactgctagagcagcttcctggatgctgtgcccttcatgtccggattatgagtacacctctggtgggctggggcagaggcatggggcagggtctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacatgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagattgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtgatgaggatgttgggaaataagagacctcccattcaacttaagggaaagtaagctgttgcaaccattccagggagcaacctgaaagtacttggtaaattaactatctttatactttctcaatgatgtagcaattacacttctaggtctcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggactatatagcacaacctattagaggaaatggctgaaatagtattctcttaatgtttaatgtgactattaagagggtattatgctggcatgtaaaacagttaattgtattcagtgtgttttaacatcactgattaattgatggcatagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgtttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtacctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaaggcaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacataaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaattagccgggcgtgacggcgggcgcctgtagtcccagctactcgggaggctgaggaaggagaatggcgtgaacctgggaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcgctgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgcttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggactgttggcttatttggaaaagtgtagtaataaaagagatgttcccagaagaagattgaccaattgatgaacagaaatgaaagtagagagagaacagaaatttagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccagatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtttattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgagtcagtgatggggcgaatatgtttcatgtgtggaaagataaataaaagggatgatgcatgaccagaaaggaggactgtggcagaaacagcctagatgctcaccaatcttatttctactgtttgggcagatggaaactgctatagttcaaagcctctcttggagttagattgcaatcatatgactgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagctgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtagttaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccactttttttttgaaacggagtttcactcgtgttgcccaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttaccatgttggccaggctggtctggaactcctggcctcgtgatctgcctgcctcagcctcccaaagtgctgagattacaggcgtgagccacagcgcccggccatactttattctttatgatacaatgtctcactctgttgtccaggctggaatgcagtggcagaatcacaggtcactgcagccttgacctcctgggctaaagtaatcctctaccccagccttccaagtagctgggaccacaggcgtgcaccaccacgcctggctaatttttaaattttttgtgggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaacagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccactcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaacctcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcacccaccaccatgcctggctaatttttgtgtttttagtagagacggggttttaccatgttggccaggctggtctcgaactcctgacctcaggtgatccacccgcctcggcctccctaagtgctgggattacagtcatgaaccaccgtgcccggccgagagatgaatattaaaacatatttgagggactttagaaattgtcagtctttaaagtctgtaagaaggatggtctggatgactcctttagcatgaactcattatttagtagatgactccatcccaattagtatttatgcctgtggaaatctcatatgaagagctagatctgattagcagctctattatatctagcttaatgctcacaatttgttccacaaagccattctctctctctctctcgtctttccctccttccattttgttagatcacatattataatagttatatgctttaaacccttatttagaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagctgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttctacgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttattcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggattacctagctagtaaaatgaatgcaggaaaaagggaaaggccaagaacagtcacatctatctgtcttttcattttgtttcttcttttgcttttcatgcttagaaattctttctccgcctagagatgaaatgaatattcaattatggtttcttccaattgtttctggtgctcatttttatatttatatttaacctaagataatctgggatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcccgcttgcaatgtgcatctgaagccaggaggatgtctctccaactgatcgtatatttctttcttgtttttcctttttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataattcaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttataggaagcagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatcttggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggacggagccctcagtttgtggaatctgactctacctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagtcctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattggtcacagccagtgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacctgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgtcccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccagtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggagtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgagaaggagctaattgctagacttgtattactacttgcaatgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctccctccctccctcctttctttctttctttcttccttccttccttccttccttccttccttccttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggcgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctaggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagtcctgccaacatcttgaatttagtaagattactgtgacttctaatcttgtggcttttgtcggtctagtccacaggcagtaaggtttgttttgggaaaggactgttatcatctttctttcaaagctaaactataaaataagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccatttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactgaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccatcttgggcacatgtcatcaggacctcctgagactgtgtcacgggagcaagtcctcagcactggcaaacttactaaattgactgagacctgtcttagatttttggggttcacaacattcattagctattgggggtctaggactgaaatttaaaggcatagatgaagtctgacagatccaatctgatgttaactttgggattttctttagttaccactcagtgccccagtcctccttaaaatactttacacctccaagtctttttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagacccaatggtaaataaaccctgactgtcattcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatacttttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcccggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttttattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgttgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccaccctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaaaaaaaaggaagtggagaggaaggggaagggttgtctgcaatgagctagaaagttagtcttttttttttttttaaataaggaaaggaatgcgaggtggtactgataatgcctggtactgtagcgtgcctgggcattaaaggagaaaaacggaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaaaaaagaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaagtaacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacactcatatttattgacagcattgtttggcctcttatatatataaaatgtcatttattttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgcgcattaggccagggacatcaggcttcaagtaaatctaaaatctaggagattattctttgtagggtagaggagacgcaaaggacataggtttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatataccgtatatatatatatatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggaaaattttaggctattacctcctgaaatattttttccctacattctgtctaaatctattgaaaagagttacgagtgggtaggtaatttggtgactggtctcttggtatgagagcatctcattccttttggtgtcaccaattctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcgtggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacagagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagccactgcacctggcctcatttagattttatgttatttatttatagcttgataatattttgtcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgttttgttttgtttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtattttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctatcatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggatattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccatcagtgttctgtattcagtaaacccatctcacatgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccaccccaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaagaaactcactcaaaaccgctcaactgcacggaaactgaacaacctgctcctgaatgactactgggtacataacgaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcacactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaagggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcaggacataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaactccatcaaaaaatgggcaaaggatatgaacagacaattctcaaaagaagacatttatgcagccaacggacacatgaaaaagtgctcatcgtcactggccatcagagaaatggaaatcaaaaccacaatgagataccatctcacaccagttagaacagcgatcattaaaaagtcaagaaacaagaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacagcatggaatactatgcagccataaaaaaggatgagttcatgtcctttgtaggtacacggatgaagctggaaaccatcattctgagcaaactatcgcaaggagagaaaaccaaacaccgcatgttctcactcataggtgggaattgaacaatgagaacagctggacacagggcggggagcatcacacattggggcctgtcgtggggttggggaagcagggagggatagcattaggagagatacctaatgtaaacgatgaattaacaggtgcagcacaccaacatggcacttgtatacatatgtaacaacctgcccgttgtgcaaatgtaccctagaacttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtaaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaagtctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaataaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttaccttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttctttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaattcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagagtggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttagtatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatctttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccctggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttctcttgttttcttttctattttttctattttttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacagcatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtatacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttttgatcttagaggaaacccaaaaggtgttcacttaggtctggttttaaacaggcagaacaacatattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagattgtgccactgtactgcgccactgcactccagcctgggtgacagagcaagactctgcacccccaaccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctaaattctagattctggggatagagccaaggaggacaagctgaagttctcagttttaagtgactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcctaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacgctttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgaggggaaagaaaggtaatcatatttatgttagtttcacaatccaagttttaaattggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaaactaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttttttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgacacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatctgaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaggatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggctgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaaccatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaatattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctaccgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaggtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttactcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaagggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataattgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttttaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaaccattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacaaaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtgtgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagaataggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaataatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattaaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtagatatctataagataaaacaaatctatacattgtgtttttcagctagaggcagaaactcattgtcactatatcctagataaaatcttcttgatgttattaatcctacggattaatacgaaagtgcaggaaattatcgggtcatggaagagtcacagaaagtgcaggaaattatggggtatattttaataaaattactgaagacacatagataatatcttcacctatattataaaagtgctgagtctaggcctagcatttttcttcgcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctatagtggatctacagtatataggccaagatcttatgatgcacagggcagccccctacaacaaagaattaaatggttcaatatgttagtggtgccaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacactacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaagcttgagaatgattgggagtgaacaaagtgcactgggttttggcaagaaaatacctcatgaattttgggagatatgagtttagcataaattaaaaatagtgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcatcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctcctactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatcttaacaatggagtggacattatttagataacttgtggttctttcctaggcacccaactttttgctcaaagtagttaggaacaaattatcttcccaaatattattgttctaaacatatgtagtctaagattctgtatcactatcttttttttttttttttgagacagagtctccttgttgagacagagtctccaggcagaagtgcaatggtgcgatcttggctcactgcaacctctgcctcacaggttcaagcgattctcctgcctcagcctccccagtgattgggactacaggtgcccgcctaatttttccatttttagtagagacagggtttcaccatgttggccaggctggtctcaaactcttgacctcaggtgatctgccctcctcggcctccgaaagtgctgggattacaggtgtaagccaccgcacccggtatcccccgctttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcttcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtaggttgtgtaattttttgtttacttttctttgaaataattatatatctacaggaagttgcaaagatagtacagaggagtcacaacatctcacccagttttctccaatgattacatctcacataactatagttcaatataagatctgggaaactgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggctttttgttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaactgtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcttagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaatttttggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccgtccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccacttataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattatggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggaatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgtttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagaggtgccatacacttttaaacaatccgatctcacaagagctcactcactattgcaaagataactccaagccgtgagtgattggctcccatgacctgaacacctcccaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccaaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaaaaaaaaaaaaaaaaaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcatcttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaaattcttccattctttacctgttacccagttgccaagtcgctttcacattttccaatatctttatagcaatgccacactcatagttaccaattttctgtgttaggctgttcttgcattgctattaagaaatatctgaggctgggtaatttattagaaaagatgtttaattggctcatggcttttcagactttatagtaagcctgatgctggcattaacttagctcctagggaggcatcaggaagcttataatcatggtgggaggtgaaaggggagcaggaacatcatgtggtgaaagcaggagcgagagagagagagagtgggaggaggtgccacacacttttaaacaaccagatatcgtgacagttcacttgctatcgcaaagacagcactatgctgtcagggatccgttacccaaacaactcccaccagcctcacttccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttcctgtgcagaagctctttagtttaattagatcccagttgtcaatttttgttttagttgcaattgcttttagggtctttgttataaaagctttgctaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatacccagcaccatttattgagtagggagtcctttccccatttcttgttatggtcagctttgtcaaagatgagatggttgtagacatgcagctttacttctggcttctctatttggttccattgatctatgtgtctactttttttgtactagcaccatgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgaccaggctggagtgcagtgccacaactatagttcactgcagccttgaactcctgggctcaagcgatcctcccacttcagtctcctgagtagcggggactataggcattcaccaccacacatggctaattttttagatttttggtagagatggagtcttgccatgttgctcatgctggtcttgaactcctgagctcaagcaatcctcctgcctctgcctcctaaagtgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttaatgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtagtgagagtgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggttttgccatgttggtcaggctggtcttgaacacttgacctcaggtgatccacacatctcggcctcccaaagtgctgggattacaggcatgagccaccgtgcccagccatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccttgttggctgtttttttaaaattactggttcaattttggaactcattatttatcttctcaggtattcaatttcttcctggttcaatattgggagtttgtgtttccaagaatttatccattccttctagattttctagtttgtgtgcacagaggtgtttacaatcatctttgaaattttttgtaaaaaatatttctcttccctttggcatttctgatggtgcttatttgaaagttctttcttttttttctttgttagtcttgctagcagtgtatcaatcttatttattctttcaaagaacaagttgtttggtttcattgatcttttatatggatttttgtgtctctatttcattcagttcagctctaattttggttatttttgtcttgtgctagtttaggggttcacttactcttgtttttctagttcctcaaggtgtgatgctacattgttaatttaagatatttatatcttttcgatgttggcattttgccccataaactttcctgttaatactgctttacctgtgtcccagaaattctggcatgttgtatctttattttcattaatttcaaagaatttcttgctttctgtcttaatttcattctttactcaaaagacattcaggagcaggctgtttaatttccatgtaattgtataattttgagagatcttggtattgatttctatttttattgcactgtggtctgagagtgtgattggaatgatttttaaaaatttgtttagaattgctttatggccaagtgcatggttgatcttagagtatgtgccatacatatgcagatgaaaagaatgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgtttttcatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggtgcaatctgagctcactacatcctctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaagaatgctggctgagtataggtccccaatctcttttggcttataaggtttctgctgaaggttctgctgttatcctgatatcaccccctttgtatgtgacctgtccctttgctctactgcttttaagattttttctttcatgttgaccttggagaatctgacgacaaggcgtctggaggatgggtgtcttgtatgttatatctctggggttctctgaatttcttgaatttgtatgttaacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctaactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgcccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtcgtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaagtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatttactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgtgttgtggaatgggagggaacgaagagttcaaacaattgactggaaaggttttattcatctaagactttcccaaacagcaaatccttgaagggaatgagatccaggtgttagtgtacagtctagtcatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaagtaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaatatgtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcacatgtgcagacagatgtgatttcaacaactagactgtaaactccatgagggtggggacactaactggttcatttttatatccttcacagttcacaggaaactataatattgtttatggcagttgttctataaagatttattaaataaaaataaagagtaataaaagcaaacaaataaatatacgtgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctttatacctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtctctaacacattaatcagtacctctttggcgtagatgtagtcagcttaaattttacaatcactgtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatacaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttaaatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaatcaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccaggcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactacccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagaaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaagtagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcattggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacataaacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcttggtataaggcagaaaacattaaaagggtaaactgacccttttatgctctaagatataaacctctgtcatctcactgactaatgttttaaatgctagagtgaaagcaagtaaacattggctttggctgtgaatattctggtggcacacatttatgtcgttgatgaatagtgtaccttgaaaagccttaacccttacgccgttagcatttcatcttgttcatctgactgcccaaacatctatatttaaacaaatccacaggggatctgttctctaggactttgctggagaaccttgatgtgtcggaaaactgttcctattaatagaggaattatatctcgagtggctggcatatgttaactaatggatactattaatagtaataacaaaaataaaaaatcattacaatattactactatttgaatcactgactatgtatgagagacattataagtgttttatctatgttaagtatatttccaacacgacacaataggaggtaattgccattattatagaagtaggcataattatctctatcaacattctagtccacttttccatcattatctgttgcataaactcatgcaaaatcttctaaatgatctacacttttcacaatctggcctttttgcgatgtaatccattgacaacattgagagctttttaaagaaagggaatctgataatatctctccatttctgaactctgtgcagtagctcccctttgcccttaatagatacttagatctccttatagttatattgcttcaacttacctctctagcatcatctgctactttactcagctttttcctgcatactaatttgaaaccttaggcactgcctttacttcactacctgcttttctttttgtgttttcctctccccctcatcttttcatctactcctagacattattgaggactcactttatcaatgactttgagatctcttctacatgtttccttagcattgtgaccttataacacttttagacttttcctttttacttgcttatagtctatctttcaaagtacaacgtaaggcatgagggagcagaaagtgcctacatttcttctctgaaaatccagcacttatccgtggtttgtgctgatcaattcataaatattccttgaaggaatgacttatttttttttttacattgcacaatgaaggctttcattgaatcaaccctgttttcagagtctctttagtatccctctttgatatttaatgacactaaagtttacacagttgtgatgatatagcaacatatgagtttctaatggtaggtcactttctttgacctcccgtatttctctcactgtgagtcaaacactctgaatgaaaacatatctggccattccttctgaaatgcaaagcaaataaatcaaacatgaatacatttaccttaggcagggttttggctggtttacagtggagttcccccacaaaatcgacatttggtaagggtgggtgaagaaattcaaaatcccagtacgtttgaatgagccacacttcagctttccccattgtctcaaataatgtacattaataaaataaatatatacatatatttttatatataagcataacaattttatatattgcatattacttatatataaggaaagcaaaatgttcagagaattaagaggaaattacatatatttttttctttttcttttttttattatactttaagttttagggtacatgtgcacattgtgcaggttagttacatatgtatacatgtgccatgctggtgcactgcacccactaactcgtcatctagcattaggtatatctcccaatgctatccctgccccctgcccctaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaataatgtcacaataaacatacgtgtgcatgtgtctttatagcagtatgatttttagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcattttttcatgtcttttttggctgcataaatgtcttcttttgagaagtgtctgttcatgtcctttgcccactttttgatggggttgtttgtttttttcttgtaaatttgtttgagttcattgtagattctggatattagccctttgtcagttgagtaggttgcaaaaattttctcccattctgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgcatctgtaaattaccttgggcagtatggccattttcacgatatcgattcttcctacccatgagcagggaatgttcttccatttgtttgtatcctcttttatttccttgagcagtggtttgcagttctccttgaagaggtccttcatatcccttgtaatttggattcctaggtatttaattctctttgaagcaattgtgaatgggagttcactcatgatttggctctctgtttgtctgttgttggtgtataagaatgcttgtgattttggtacattgattttgtatcctgagactttgctaaagttgcttatcagcttaaggagattttgggctgagacaatggggttttctagatatacaatcatgtcttctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggatacgctttttgatgtgctgctggattcgatttggcagtattttattgaggatttttgcatcaatgttcatcaaggatattggtctaaaattctcttttttggttgtgtctctgcctggctttggtattagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaagctattgattattgccataatttcagatcctgttattggtctattcagagattcaccttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctactttgattgtactgtggtctgagagatagtttgttgtaatttctgttcttttacatttgctgaggagagctttacttccaagtacgtggtcaattttggaataggtgtggtgtggtgctgaaaaaaatgtatattctgttgatttggggtggagagttttgtagatgtctattaggtccgcttggtgcagagctgagttcaattcctgggtatccttgttgactttctctctcgttgatctgtctaatgttgacagtggggtgttaaagtctcccattattaatgtgtgggagtctaagtctctttgtaggtcacttaggacttgctttatgaatctgggtgctcctgtattgggtgcatgtatatttaggatagttagctcttcttgttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgggatgggtttcctgaatacagcacactgatgggtcttgactttttatccaatttgccagtctgtgtcttttaattggagcatttagtccatttacatttaaagttaatattgttatgtgtgaatttgatcctgtcattatgatgttagctggttattttgctagttagttgatgcagtttcttcctagtctcaatggtctttacattttggcatgattttgcagcagctggtaccggttgttcctttccatgtttagcatttccttcaggagctcttttagggcaggactggtggtgacaaaatctttcagcatttgcttgtctgtaaagtattttatttctccttcacttatgaaacttagtttggctggatatgaaattctgggttgaaaattcttttctttaagaatgttgagtattggcccccactctcttctggcttgtagggtttctgccgagagatccactgttagtctgatgggcttccctttgagggtaagcccacccttctctctgtctgcccttaacatttttttcttcatttcaactttggtgaatctgacaattatgtgtcttggagttgctcttctcgaggagtatctttgtggcgttctttgtatttcctgaatctgaatgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttatttgcctttggtttgaatgtcctcccgtacctcagagtaatttgatcgtctgaagccttcttctctcagctcgtcaaagtcattctccatccagctttgttccgttgctggtgaggaactatgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccccaccgtgtgaggtgtcagtgtgcccctgctgcggggtgcctctcagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttccctgttgctttgtttacctaagcaagcctgggcaatggcgggcgcccctcccccagcctcactgccaccttgcagtttgatctcagactgctgtgctagcaatcagcgagactccatgggcgtaggaccctccgatccaggtgcgggatataatctcgtggtgcaccattttttaagcccgtcggaaaagcccagtatttgggtgggagtgacccgattttccaggtacgtccctcacccctttctttgactcggaaagggaactccctgaccccttgtgcttcccaagtgaggcattgcctcgccctgctttggctcacgcatggtacgcgcacccactgacctgtgcccactgtctggcactccctagtgagatgaacccggtacctcagatggaaatgcagaaatcacctgtcttctgcgtcgctcacactgggagctgtagacctgagctgttcctattcggccatcttcggaaattacatatttaatgtaacattagtatattcacaatctcaaatagttattaaaataagccactatggacttaaatatgcatttgtttcctctctgaaactgcagtagtaactgatatacatttaaacagctctttgagctccaggatgaattcatcttactatactcataaaaacagctttctacgaagtgcacaatctcgtttccacaatttatcaagtcagtcccttgatccttggttctccaagtgaactgtgagttttctgagagtatgcctgaaatccttgaacatactactgcttctagttcacgttaagattttaacaatattagctttaaaatacatacattaaaaatgatagctagtatattttcagaatttattgaaacagagatatgtgctcccccttaacttggcccatattttccctaataaagagatgtagttaataaagtatagattaaaagcttgaatgttcactttcaacaagattttaattcacaaagcaaataatttctcagttgttagtgaatgatatacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattgatagttatgctagaaatatgtgtagctcctcatctaaatgtctgccttcatcaagttgtttattgatatatgttttgccttttttaaagatgaaaaaagtatagtaaaatacgtatatagttgcttaaagaaatcataagtgctttactttgtagtttttttttttttaattcctgtagtgtcctataggagtgatgaccaaagggttctagctgagcctataatatcaacatttctataatatttgtgagattgatagatcatcttacatttggcattcatcatttcatttaaacaacactatcctcttacattatatttatatacgctcaccttcaaaggcaaaaggaaagttaggacttattaatcattgattagaaacatgacttacctagaacttcactgtaaaacttctcccacttctcgtatcaaacatttgaaaccaaaagtcaaaataaagcacatgtattagatttttaatcctctccacgaatgtcattttaccacttaattcagacagaacagcaggtatgcgggaaatggggaatggaagtcctccattatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgaaaaatatgaccaaaatgcatcttttggaagatcgtatatccatctattgatcagtttcacaacaagaccctcaaaattatttttaattagagatgttggataaacttcaaatttaatagcagatgatttactagggtcaataataatggaagccgaagatgtcaacacagtcatcttgtggcctctccaaacaagttcatccaggattgtctttatattcatccaatggctgtattctgtgggccacagcagcacctttccacaactcccagagctaaagtaacaactgagttgtatcaggagaatatttgacatcgatttcaatgtcctcctggtgcaatgcaatgtttcttttcaaattgctgtttctttctgtctttctcatacttacatctgagcataaatcaatcaagtgaaagtataactgctacaattcaaagtagcagttaccatataatttctaaattatcataggaattgtctgttaccatacaatttctaaattaccataggaattttcagattgtttttcacagtggttgcttccatttccattctcaccagcaatgtataagaattttaatttcttcccaacattgccaacacttgggattacatttcgtttgattatagccagtgtgaatgaagtgatatctcattatgctttacctttccttgatatgaaatcatgttgagaatgttttgcctagttttgattgaattatttgtcttcttatggacttgtgtttttaatatttttgatgtaagaaccttatcacatgtatgatttccttgtatttttttattctttgggctgtccttttactttcttaatggtgttaattgaagcacaaaagtattgattttaatgaagtccaactaatcaattttaatttggttgcttttatttttgattttatatctcacaaaccatttccaagttatgaaaattagtacctgttatttattattagagttttatagttctagtgcttacatttaagtttttgatcacctatgaattagcttttgtaagtgatttgaggtagagggtcccaacttaattattttgtatacagataatcatttttcccacttatatttgttgaataatctattctttcccctattaaaacgttttgaaacttttgtcaaaaactttaaatgcatgggcatatttctatgttctaaaatcattccattgatctacatgtctatctgtaggcctgtatcacactctcttgattatcatatatttgtatttgtctttaaaggcaggaaatgtaagttttccagcttttttttatttaaattgtttcagttttttttttaatttttttcttcttgtttttttttttttttttttaagagatagaagtcttactatattgcccaggctagattcaaatttctgggctcaagcaatcctcccaacacagcttcttgagtagctggaattacaggtgtgtttcactatacctagcttcttttggctattagtatgtctcttgaatatgtacataaatttcaggatcagtttgtctgtttatacaaagaagcaatctgggattttgatacggattgcattgatttggtatatcagtttggggagtagagtatggtcattatcacaattttaggtctttcaataaatgaaaatgagatgcctttctatttatttagatgttcttatttccacagtgttttgtagattttgttacagtggctagctagtcagacacaaacagggcagaagagggctcccacaccctaccaggaaagtcaggtgaccatcagttaatggccaggcagttgtcacactgtttaaaacaataattggttgcagccagccagggaaaggcagatttcttatagatagaaaaaatcaaatctggtaatcagcagcttcctgataagatctcagcagttgggagagtgggttcacacacacacattaagaggccaaatggtggagtacgacattccgggggcaccagaaaagggaagaatgcctcaggggagcatgcatatgactccagtaaatatactgtgcatgctcatctcctaagtggtagcaggccatcacacatgccagcaggtcattctaaggaaagaatcaaggaaaagggaagcaggacccggaaagtatgccaacatataaaaccctaagtcaaaggtcaaacaccacactttaccttcaaaatggctacttgtatctatcccaagtgtactttcctttctttcctgctataaaactttttaataaattttcacttctgttctgaaacttgtgctggtctctttttctgccttatgccgctcagtcaaattcattcttctgaggaggcaagaattcaggttgctgcagaaccataaatacttgctgcagtaaccaccgctggtaataatgtcacagtaagagttgtacaattttttgataaacttattgctaagaattatattttttcatggtattataggggtgactgtgtaatctttattttagtttaaatttccattgcaattgtgtagattttttgtttgtttatttaccttgtatcccaaaatcttgttttattagtttacttgaatattttttagtggatttgtaaaaattttctattataagatcatgatatatgccaatagagacagtttaacttctttctttctaatgtggattccttttatttcattttctttcctatttgttggctgaaagttctactgcaatattgagtgaaagtgagaagagtcagtttagtgtgatgttagctgtgtgtttttttatagacactattgatcagttttagaatgttcccctttacttctagtttaagtgttcttatcatgaagaatattgaatttcattaagtaagtttttctgcagttatcgaaatgattatgcagttttttcctttattctaatgatatgatatattagttggctttttcagatgttaacataactttgcattcctggaataaagttcatttgtttatggcatttaagcttttcatgtgttcctgaattttgtttgctagtgtgaaaagaaagtaaaaatcttgagtcattaaactcactatgtcaaagagaaaagttaatcttgggaaatgaagcatgtaaaattggctcccattttgttcctaaacagatagctgcaaagatagaaggccacatacctccccagatggcctccttcccaatttactcacaaggaaattcacaaggccctaaaacagagttctcttgaattttaccctgacaatataaattaacattttatattcacaggtatataaaagacaggacttgaagccattgtgtggtttttagcataagggcttactgaatggtggttatgttttctcctcttttattttttggagaattagttattttaaatacttgatagaagtatagagcttttatattttctactctaccatttccagttattacccagctatgtttttctaaataatatttcattggaagccgtcagacactgggcttttcttttatgggagactttttcttacagcttcaatcttgttacttgttattagtttgttcaggttttttatttcttcatgggtctattttggccggttgtatgtgtccaggaatttattaatatcatctaggttttccaaattgttggtatatagttgttcataatattctgtaataatttgtgtttctgtaatctcagtttttatgtctcctctttcacttctgattttatttagtgggtctgttctcactttttcttacttagtctagctaacagtttgttgattttgtttacttttacagagtttaccttattgactatggctgcttttgtactacaatggaagagttgagtaggcacaggagtccaaagggtttgcaaattccaaaaatgtttaccatctgaggctttatagaacctattctgatctctgctctacagtaagcaggttcgttttttcctttaacctttctatatattcaatgcaattttactaaaacagtatagatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaatgcataattttttagatccactttgtctttagaaaaccgtgaaattgtatcattggtgtctggatacaagtcattttagtggaaaaagccaagtggattctctttgcattagtttcctggcttcttaaaacagaagttattctctgttattcttatctctctaagccagaaggtcaaaatctgtgttctcagggttcatttgttctggaggctctaggagggaaacaaccaatgcctgtctcttggcctttattggttaccgacaattcttggaatcccgtggcttgtgacttctctccaacttctgtttcctcagcatcatcttttcttttctttcttactagttttatcctgcctttattcttttcaaaagaaactgtgtcttgctatattgacttggctgatcttgaactcctggcctcaagggatcctcctgcctttctccttataagaatatctgtcattggatttaaagcacatcgtaaatccagaataaacttgtcttgattttcttactttacttacatctgcaaagatcttttctccattaaattcactttaatagattctggaggttactcactgcacacatttttggcaaagacatctattcaattcactatatgcatgcaacttcttcattcctccattaccacagatgtcaggtgaccaagaaaatggaaaataatattgcattacatgcctggggattgtgaaaattaaagaccttaaaggtttaaaggatgcaggatgatgggctccattacatctttgattaaaagtctgaccactgcaaaatccaacagatcctagagtctggtagtggactcctgcaatttccaccaagtagttgctccactggcatcccctgttccagatggagtacctttgctagaccacatgaaaattcatattattaaaatgtctgtactcctgacagtgattaatagatttactgcaatctctattaaattcctatggtatttcttatagaattgaaaaaacttaaaatttatatgaaaacacaaaagactgttaatatgcaaacatgatttttttaaaaatgcacagaatgatcttatatattgcttttaagaaagcaactataagactttatagaaaaaatactttcttttataggttagaactgaatctactcagttttattcaagattaaatctgtccacttcttcttcacctcagaatgttaacgtttttataggattattcaaaagtaccttaattatgccctgttctgcatgcacaatccaggagacagtaagttcagagaattatagtccaacttgtttggactgacttttgttccaattttggggattggcttttggtcgttcatttcttctacggtcaaaatgtaagtggactcattttgatccatgtcatctctctcgaaagaaatatgctgtttccaaattttaaactgaacttagcttggaaaagaaggcctagtaacagagataggagttgtcattatatctctagctatcattatataatgaaagccagactttgtcaactcactcttttaccagaattttaaactccctaatagatgattgaagtgataacatgatttcctttaatgctgctcacagacttcccactttatttagaaaattcattattatagagcctgggtgatggataaagtaaggcattcacttgtttttcttatgttatagacagaagctgggtttcggtccataatatcaaaatgtcatctgttatttatattgacataactttctgaaaacagtgcaagtcaagatttgcagtgtttaatgaaacctgaattttgaaattttacctccttttgtgggaaataattttaagaatcagatatagagtttaaaatttaaagttctgtcggatctaggaaagattattttgctatatttgtgtttctctctgtgaaatttttgatcaccaattccaataaaaaccacaatagcattttctccagagatttcaatgaattctttgatttcctgtaaagaaataatttgtacatcaataagagaaatgcatcatataaatttcaaaaatagatgcatataattttaatagctttactgaaggaagaacaattgatatacaaaaaacctgcaagtatttttacttatatatttatattatttatatatatataaattgatgagttttgacatatacatgcacctatgatgctatcattacaacaatgaaggtaataaacatatccatcacctacaaaagctctctttgtcactctttgtttttgatagtaataatgcttaacatgagattgaccctcttaacacattattaagtgtacaataccgtgttgttaactataggcattatattgtagagcaaatttctatgcttattcataaacataagtgaaactttatacccactgaacaacagctccccatttctctctctcccaaacccctggaaatcactattttatttctgcttcaattagtttgcctattttacttaactaatataagtggaatcataaaatatttgtcctttttttattattatactttaagttctagggtacatgtgcacaacgtgcaggtttgttacatatgtatacatgtgccatgttggtgtgctgcactcattaactcatcttttacattaggtatatctcctaatgctatccctcccccttcccccaaccccacgacagaccccggtgtgtgatgttccccttcctgtgtccatgtgttcccattgttcaattcccacctatgagtgagaacatgcattgtttgtttttttgcccttgtgatagtttgctgagaatgatggtttccagcttcatccatgtccctacaaaggacatgaattcatccttttttattgctgcatagtattccgtggtgtatatgtgccacattttcttaatccagtctatcattgttggacatttgggttggttccaagcctttgctattgtgaatagtgccacaataaacataagtgtgcatgtgtctttatagtagcatgatttataatcctttgggcatatacccagtaatgtgatggctgggtcaaatggtatttctagttctagatccttgaggaaacaccacactgtcttccacaatggttgaactagtttacggtcctacaaagagtgtgaaactgttcctatttctccacattctctcccacacctgttgtttcctgactttataatgatcaccattctaaatggtgtgagatggtatctcattgtggttttgatttgcatttctctgatggccagtggtggtgagcactttttcatgtgtctgttggctgcataggtgtcttcttttgagaagtgtctgttcatatactttgcccactttttgatgggtttgtttgtttttttcttgtaaatttgtttgagttcactgtagattctggatattagccctttgtcagatgagtagattgtaaaaatcttctgccattctgtaggtttcctgttcactctgatggtagtttcttttgctgtgcagaagatcttcagtttaatgagatcccatttgtcaattttggcttttgttgccattgcttttagtcttttagacatgaagtccttgcccatgcctatgtcctgaatggtattgcctaggttttcttctatggtttttatagttttaggtctaacatgtaagtctttaacccatcttgaattaatttttgtgtaacatgtaaggaagggatccagtctcagctttctacatatggctagccagttttcccagcaccgtttattaaatagggaatcctttctccatttcttgtttttgtcaggtttgtccaagatcagatggttgtagatgtgtggtattatttctgagggctctgttctgttccattggtctatatctctgttttggtatcacaaccatgctgttttggttactgtagccttgtagtgtagtttgaagtcaggtagcatgatgcctccagctttgttctattggcttaggattgacttggctatgagggctcttttttggttccacatgaactttaaagtagttttttccaattctgtgaagaaagtcattggtagcttgatggggatggcatttaatctataaattaccttgggcagtgaaggcattttcacaatattgattcttcctatccatgagcatggaatattcttccacttgtttgtgtcctcttttatttcgttgagcattggtttgtagttctccttgaagaggtccttcacaacccttgtaagttggattcctaggtattttattctctttgaagcaattgtgaatgggagttcactcatgatttgactctctgtttgtctgttattgatgtataagaatgcctttgatttttgtacattgattttgtattctgagactttgctgatgttgcttatcaccttaaggagattttggactgaaatgttggggttttctaaatatacaatcatgtcatctgcaaacagggacaatttgacttcctcttttcctaattgaataccctttatttctttctcctgcttcattgccctggccagaatttacaacactatgttgaataggagtggtgagagagggcatccctgtcttgtgccagttttcaaagggaattcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttgtttctgttcatatgctggattatgtttattgatttgtgtatgttgaaccagccttgcatcccagggatgaagcccacttgatcatggtggataagctttttgatgtgctgctgtattcagtttgtcagtattttattgaggatttttccatcaatgttcctcagggatattggtctaaaattcttttttgttgttgtgtctctgcccggctttggtatcaggatgatgctggcctcataaaatgagttagggaggattccctctttttccattgattggaatagtttcagaaggaatggtaccagctccttcttgtacctctggtagaattcagctgtgaatccatctggtcctagaccttttttggttggtaggctattaattattgcctcaatttcagagcctgttatttgtccattcagggattcagtttctccctggttcagtcttgagagtgtgtatgtgtccaggaatttatccatttcttccagattttctagtttatttgcatagaggtgtttatagtattctctgatggtagtttgcatttctgtgggaacagtggtgatatcccatttatcattttttattgcatccatttgattcttacctcttttcttctttattagtcttgctagtggtctcccaattttgttgatcttttcaaaaaaccagctcctggattcgttgattttttgaaggctttcttgtgtctctatctccttcagttctgctctgatattagttatttcttgccctctgctagcttttgaatgtgtttgctcttccttccctagttcttttaattgtgatatttgggtgtcaattttagatctttcctgctttctcttgtaggcatttagtgctataaatttccctctacacactgctttgaatgtgtcccagagattctgttatgttgtttcatagttctcattggtttcaacaaacatctttatttctgccttcatttcttatttacccagtagtcattcaggagcaggttgttcagtttccatgtagttgagtggttttgagtgagtttcttaattctgagttctagtttgattgccttgtggtctgagagatagcttgttataatttctgttcttttacatttgctgaggagtgctttacttccaactatgtggccaattttggaataactgcaatgtggtgctgagaagaatgtatattctgttgatatggggtggagagttctgtagatgtctattaggtccgcttggtgcagagctaagttcaattcctggatatcctttttaactttctgtcttgttgatctgtctaatgttgacagtggggtgttaaagtctccagttattaatgtgtgggagtctaagtctctttgtaggttactcaggacttgctttatgaatctgggtgctcctgtattgggtgcatatatatttaggatagttagatcttcttgttgaattgatccctttaccattatgtgacagccttctttgtctcttttgatctttgttggtttaaagtctgttttatcagagactaggattgcaacatctgcctttttttgttttccatttgcttagtagatctttctccattcctttattttgagcctatgtgtgtttctgcacatgatatgggtctcctaaatacagcacactgatgggtcttgactatccaactagcaatttggataaaatatcttctaattggagcatttagcccattgacatttaaggttaatattgttatgtgtgaatttgatcctgtggttatgatgttagctggttattttgctcgttagttgatgcagtttctttctggcatcgatggtctttaaaatttgtcatgtttttgcactggctggtaccagttgttcctttccatgtttagtgcttctttcaggagctcttgtaagacaggactggtggccacaaaatctctcagcatttgcttgtctacaaagtgttttacttctccttgacttatgaagcttagtttggctggatatgacattctgggttgaaaattcttttctttaggaatgttgaatattggcccccactctcttccggcttatggagtttctgctgagagatccactgttagtctgatgggcttccctttgtgggtaacccgacctttctctctggctgcccttaatattttttccttcatttcaactttggtgaatctgacaattatgtgtatttgagttactcttcttgaggagtatctttgtggcattctctgtatttcgtgaatttgaatgttggcctgccttgctaggttggggaagttctcctggataatatcctgcagagtggtttccaacttggttccattctccctatcactttcaggtacaccagtcagacatagatttggtattttcacatagtcccatatttcttggaggctttgttcatttcattttactcttttttctctaaacttctcttctcgcttcatttcagtcatttgatcttcaatcactgataccctgtcttccagttgatcgaatcagctactgaagcttatgcatgtgtcacatagttctcctgccatggttttcagctccatcaggtcatttaaggacttctctacactggttattctagttagccctttgtctaatcttttttcaaggtttttagcttctttgtgataggttcaaactttctcctttagcttggagaagattgatcatctgaagccttcttctctcaactcttcaaagtcattctccatccagctttgttccattgctgatgaggagctgtgttcctttggagggggagaggcactgtgatttttataattttcaacttttctgctctgttttttccccatctttgtggttttatctacctttggtctttgtttatggtgacgtacagatgggattttggtgtgaatgtcttttctgtttgttagttttccttctaacgttcaggaccctcagcttcaggtctgttggagtttgctggaggtccactccagaccctgtttgcctgggtatcagcatcagaggctgcagaacggctaatattgctgaacagcaaatgttgctgcctgatcgttcctgtggaagctttgtctcagaggggtacctggccgtgtgaggtgtcagtctgcccctactgggggggtgcctcccagttaggctactcaggggtcagggacccacttgaggaggcagtctgtctgttctcagatctcaaactctttgatggggagaccactactctcttcaaagctgtcagacagggacagttaagtctgcagaggcttctgcttccttttgttcagctatgccctgccccccagaggtggagtctacagaggcaggcagccctcctgagctatggtaggctccaccttgttccaccttcctggccgctttgtttacctactcaagcctcagcaatggcgggcacccctcccccagcctcacagctgccttgcagttcaatctcagaatgctgtgctagcaatgagtgaggctccatgggcatgcgaccctccgaaccaggcatggaatataatctcctggtgttccatttgctaagactgttggaaaagcgcagtgttagtgtgggagtgacctgattttccaggtgccatctgttacagcttcccttggctaggaaagggaattccctgatcccttgtgcttcctgggtgaggagatgcctggacttgctttggctcacactccatgggttggttgcactcactgtcctgcacccactgtctgacaagccccagtgagatgaacccagtacctcagttggaaatgcagaaatcaaccatcttctgtgccgctcatgctgggagccatagactggagctgttcctattgggccatcttggaactgccccccatattagtccttcttgaacttgcttaattcacttagcataataccctctaggttcatccacattgtcacaaatggtaccttttgtcaaaccttggcaactgaattgacatttctactgcttccatatacagagaaattatactaactgaacttgtgaaaataatttattgatattaaattaaaatgctcatgaatagtttttgaattcttgtaagatcagatatggagaaaaatctcaaatttgtctttattttaatgaatgaaaaatatttatgattttgaaataattagcaatgggaaactaattaggaaaattgagatttttagattgttctactgttttgattattattgacataacataatatatcgtatatttctatatttactttaaaatacatgtttatatatacatatatatatatagacagagccatcgtgagtaaattagtgtgtatgtgtagtgggggtgtttgtgttttctttaatggatactctagcagcagttatctagtgtatgtcatgtactaattaatattgcatcccagaaacaaatcctaaaactgctttaaatttgtatcttttctctctcttctttctaagaaagaaatgtatatatggaacaatactctctgaatttgtttcattttagtataccacatgatagtgtggtgaaggagtgtgaggacaggcagacagagatgggagaaatggagagacagagagagaaagaaagaaagaaagagacagagaacttattatagtgaagccttatttatctttgtatcatgaggggctagctcaggacctggcatgaatggagcttataaagtgtatattaaaataaataggccacttatgacatgggttaagtcattcatattccaaatttaatgtaagaggttcgttctagcataaatatatatcttaggctttacaataaagtaaaatattgttacttttatacatatgatataggtttaattttgagagcacgcacaatatttatttaaaaatgctccttaaataaatttaaaaatatatttctacatgaatataatgtaacattaccaattttattgagtctctgtttttttcttataaaaagaacttacaatgataatacataagtaaaactgtaataattatacctactagacacataaaagctttgaattgaagaaaaattttacaataatctgtgtcaggttatgatttaaatttagaattactgtattctaaattctcaaacagagatcatcaatattttttagttatggtactgaattcaatagaactttaaatgtacatcatgtatgtgagctgacatagaggaatcatgattaagtaaatcaaaatagtattaatgttcaatgacatgtggtagagagaaatatttgatttttaagttagaatttaggcattcaaaacaggaatcacaggaataacaaaaggacataactctgaactatgcacaccagataagcataaaatttattttgcaaatgtttttgcagtttagtcctttgcatcagtttatattgtgggaaagtaagggagcaagaacagctgaaatgatataacacataaaaatatcagataatttttattgtaaacagatataagctgaatttgaaaacaaaattgataagaaattaaagaggaatatatttcccacttgttcctttcatatataatccaaagcctaaaattatgattctttatagaaatatcttcctgcttttctgtcatttgtcaaaagaagaataaaatcaatatttatttttagggctacattactgcatcatgaacctaaacttaattctgactctagaaaccaagtcaaaccatcaagaaatgtaaaccatgagcaaatgagaataaatgcaataaaatcacatccaatataaaaggcacggagatactacaaagagtaagaaacatcagaaagggtttaggtgaaaatataataaatattccttttctaaaatgttgtggtagtaatagtttattacttaatctacaaaaaatattgtcagtatttccatacttaccgaaatgagtatgatacctcagcctcactccttcagtatctttttaaatctattaccgtactacagtatcatttcaacaatgttaaatatttaatcacaatttaaatattaaatattaatgataaggataataatcctttactatgacctatactattcataccgttctggaaatataacatataataccagcagatcgcaagttagatagaccaaaaccctctcaaaaccaagaacaaacaaacaaaaaatacaaagcaaaacatttagcctctgcatttaaggcatgtttttcatcaatcctgatgtgctgccgggaatatacaaagaagaggtaagacatctgggattcccatgggaaaccagaaacgaatatataaatgaaatgttgagaagcccagccatcaattctccatagtaagctaaagggtcagcaaaacaaataaacttggctgcctacagcctgctgagtaactccttatttttatttgcctgccacaccatgaaagactctgcagttctaaagaagctttgtagagaaaagcaaagatatcttctgtgagggtttcttagtttactgaaagtaggagaaccttcacattaaaaggaatcagcatgatcaagcagaaggcttggtggaggtgctaacatggttatctcatatccatcaagttggagtttttctagaataacttttaaattgagtgactaaaattcatgggccagacaagtactttcccaaactttccagagtcaaagaaacacagattcagcaggaaaaaaaaaacaaaaccaaacacacacacacacacacacagaagacattcacagttttcatgaccaactcttcctttaatttacccttggtttaaaataagtacagcaagctcataagccagattcatcctaaatgtgtttcatgctttaatttctcagtcaattgatggtgaatgagtctggactttggacagcctacttattccaatagtcaaagtggaatatagctgtcctcatggaaaagatcatcaaattaagcaatatagcacaaattacataaaagctttctaaaataattttatataataggaatttatgcacttaaaattaaatacaacggaaaggatttc

SEQ ID NO: 92 - DNA, 596329 bp, Homo sapiens
  misc_feature (205792)..(305791): n is a, c, g, or t
agatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaat
